United States Patent 11,572,565 (INDUCIBLE CONTROL OF GENE EXPRESSION) - sequence listing, part 2

SEQ ID NO: 816 - DNA, 8394 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 817 - DNA, 8127 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 818 - DNA, 8127 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 819 - DNA, 7506 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 820 - DNA, 7506 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 821 - DNA, 7290 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 822 - DNA, 7290 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 823 - DNA, 6981 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 824 - DNA, 6981 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 825 - DNA, 6963 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 826 - DNA, 6963 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 827 - DNA, 6909 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 828 - DNA, 6909 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 829 - DNA, 6693 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 830 - DNA, 6693 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 831 - DNA, 6606 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 832 - DNA, 6606 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 833 - DNA, 5949 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 834 - DNA, 5949 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 835 - DNA, 6015 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtacccatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 836 - DNA, 6015 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtacccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 837 - DNA, 6282 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgcttccggagggtctggctccggatcaagtggtggcagcggtacccatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 838 - DNA, 6282 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgcttccggagggtctggctccggatcaagtggtggcagcggtacccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 839 - DNA, 6903 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtacccatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 840 - DNA, 6903 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtacccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 841 - DNA, 7428 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtacccatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 842 - DNA, 7428 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtacccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 843 - DNA, 7446 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtacccatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 844 - DNA, 7446 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtacccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 845 - DNA, 7500 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggctccggagggtctggctccggatcaagtggtggcagcggtacccatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 846 - DNA, 7500 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggctccggagggtctggctccggatcaagtggtggcagcggtacccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 847 - DNA, 7716 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtacccatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 848 - DNA, 7716 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtacccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 849 - DNA, 7803 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggtccggagggtctggctccggatcaagtggtggcagcggtacccatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 850 - DNA, 7803 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggtccggagggtctggctccggatcaagtggtggcagcggtacccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 851 - DNA, 8460 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagctccggagggtctggctccggatcaagtggtggcagcggtacccatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 852 - DNA, 8460 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagctccggagggtctggctccggatcaagtggtggcagcggtacccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 853 - DNA, 8232 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 854 - DNA, 8232 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 855 - DNA, 8139 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 856 - DNA, 8139 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 857 - DNA, 8034 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 858 - DNA, 8034 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 859 - DNA, 7890 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 860 - DNA, 7890 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 861 - DNA, 7728 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 862 - DNA, 7728 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 863 - DNA, 7659 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 864 - DNA, 7659 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 865 - DNA, 7467 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 866 - DNA, 7467 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 867 - DNA, 7260 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 868 - DNA, 7260 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 869 - DNA, 7158 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 870 - DNA, 7158 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 871 - DNA, 6951 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 872 - DNA, 6951 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 873 - DNA, 3162 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 874 - DNA, 3162 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 875 - DNA, 2895 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 876 - DNA, 2895 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 877 - DNA, 2274 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 878 - DNA, 2274 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 879 - DNA, 2058 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 880 - DNA, 2058 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 881 - DNA, 1749 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 882 - DNA, 1749 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 883 - DNA, 1731 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 884 - DNA, 1731 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 885 - DNA, 1677 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 886 - DNA, 1677 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 887 - DNA, 1461 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 888 - DNA, 1461 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 889 - DNA, 1374 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 890 - DNA, 1374 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 891 - DNA, 717 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 892 - DNA, 717 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 893 - DNA, 783 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtacccatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtga

SEQ ID NO: 894 - DNA, 783 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtacccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtga

SEQ ID NO: 895 - DNA, 1050 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgcttccggagggtctggctccggatcaagtggtggcagcggtacccatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtga

SEQ ID NO: 896 - DNA, 1050 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgcttccggagggtctggctccggatcaagtggtggcagcggtacccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtga

SEQ ID NO: 897 - DNA, 1671 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtacccatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtga

SEQ ID NO: 898 - DNA, 1671 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtacccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtga

SEQ ID NO: 899 - DNA, 2196 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtacccatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtga

SEQ ID NO: 900 - DNA, 2196 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtacccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtga

SEQ ID NO: 901 - DNA, 2214 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtacccatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtga

SEQ ID NO: 902 - DNA, 2214 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtacccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtga

SEQ ID NO: 903 - DNA, 2268 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggctccggagggtctggctccggatcaagtggtggcagcggtacccatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtga

SEQ ID NO: 904 - DNA, 2268 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggctccggagggtctggctccggatcaagtggtggcagcggtacccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtga

SEQ ID NO: 905 - DNA, 2484 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtacccatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtga

SEQ ID NO: 906 - DNA, 2484 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtacccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtga

SEQ ID NO: 907 - DNA, 2571 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggtccggagggtctggctccggatcaagtggtggcagcggtacccatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtga

SEQ ID NO: 908 - DNA, 2571 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggtccggagggtctggctccggatcaagtggtggcagcggtacccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtga

SEQ ID NO: 909 - DNA, 3228 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagctccggagggtctggctccggatcaagtggtggcagcggtacccatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtga

SEQ ID NO: 910 - DNA, 3228 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagctccggagggtctggctccggatcaagtggtggcagcggtacccatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaacccaagaaaaagcggaaggtgtga

SEQ ID NO: 911 - DNA, 3000 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 912 - DNA, 3000 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 913 - DNA, 2907 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 914 - DNA, 2907 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 915 - DNA, 2802 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 916 - DNA, 2802 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 917 - DNA, 2658 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 918 - DNA, 2658 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 919 - DNA, 2496 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 920 - DNA, 2496 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 921 - DNA, 2427 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 922 - DNA, 2427 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 923 - DNA, 2235 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 924 - DNA, 2235 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 925 - DNA, 2028 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 926 - DNA, 2028 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 927 - DNA, 1926 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 928 - DNA, 1926 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 929 - DNA, 1719 bp, Artificial Sequence
  synthetic polynucleotide
atgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 930 - DNA, 1719 bp, Artificial Sequence
  synthetic polynucleotide
atgcatactctttatgcccccggtggatatgacattatgggatatctgaggcagatcaggaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 931 - protein, 1053 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 932 - protein, 1053 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 933 - protein, 964 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 934 - protein, 964 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 935 - protein, 41116 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTGKVSEYFDAVNDEKKYNDRLLKLLCVPFGYCIPRFKNLSIEALFDRNEAAKFDKEKKKVSGNSGSGPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTGKVSEYFDAVNDEKKYNDRLLKLLCVPFGYCIPRFKNLSIEALFDRNEAAKFDKEKKKVSGNSGSGPKKKRKVMIEKKKSFAKGMGVKSTLVSGSKVYMTTFAEGSDARLEKIVEGDSIRSVNEGEAFSAEMADKNAGYKIGNAKFSHPKGYAVVANNPLYTSGGSGSGSSGGSGTHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKVMIEKKKSFAKGMGVKSTLVSGSKVYMTTFAEGSDARLEKIVEGDSIRSVNEGEAFSAEMADKNAGYKIGNAKFSHPKGYAVVANNPLYTSGGSGSGSSGGSGTHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKVMIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAASGGSGSGSSGGSGTHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKVMIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAASGGSGSGSSGGSGTHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKVMIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLSGGSGSGSSGGSGTHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKVMIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLSGGSGSGSSGGSGTHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKVMIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSGGSGSGSSGGSGTHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKVMIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSGGSGSGSSGGSGTHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKVMIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKSGGSGSGSSGGSGTHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKVMIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKSGGSGSGSSGGSGTHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKVMIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGSGGSGSGSSGGSGTHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKVMIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGSGGSGSGSSGGSGTHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKVMIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKSGGSGSGSSGGSGTHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKVMIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKSGGSGSGSSGGSGTHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKVMIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSGGSGSGSSGGSGTHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKVMIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSGGSGSGSSGGSGTHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKVMIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSSGGSGSGSSGGSGTHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKVMIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSSGGSGSGSSGGSGTHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKVMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKVMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKVMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKVMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKVMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKVMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKVMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKVMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKVMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKVMHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKVMHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 936 - protein, 757 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 937 - protein, 685 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 938 - protein, 685 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 939 - protein, 582 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 940 - protein, 582 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 941 - protein, 576 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 942 - protein, 576 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 943 - protein, 558 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 944 - protein, 558 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 945 - protein, 486 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 946 - protein, 486 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 947 - protein, 457 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 948 - protein, 457 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 949 - protein, 238 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTGKVSEYFDAVNDEKKYNDRLLKLLCVPFGYCIPRFKNLSIEALFDRNEAAKFDKEKKKVSGNSGSGPKKKRKV

SEQ ID NO: 950 - protein, 238 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTGKVSEYFDAVNDEKKYNDRLLKLLCVPFGYCIPRFKNLSIEALFDRNEAAKFDKEKKKVSGNSGSGPKKKRKV

SEQ ID NO: 951 - protein, 260 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTSGGSGSGSSGGSGTHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKV

SEQ ID NO: 952 - protein, 260 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTSGGSGSGSSGGSGTHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKV

SEQ ID NO: 953 - protein, 349 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAASGGSGSGSSGGSGTHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKV

SEQ ID NO: 954 - protein, 349 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAASGGSGSGSSGGSGTHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKV

SEQ ID NO: 955 - protein, 556 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLSGGSGSGSSGGSGTHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKV

SEQ ID NO: 956 - protein, 556 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLSGGSGSGSSGGSGTHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKV

SEQ ID NO: 957 - protein, 731 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSGGSGSGSSGGSGTHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKV

SEQ ID NO: 958 - protein, 731 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSGGSGSGSSGGSGTHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKV

SEQ ID NO: 959 - protein, 737 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKSGGSGSGSSGGSGTHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKV

SEQ ID NO: 960 - protein, 737 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKSGGSGSGSSGGSGTHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKV

SEQ ID NO: 961 - protein, 755 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGSGGSGSGSSGGSGTHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKV

SEQ ID NO: 962 - protein, 755 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGSGGSGSGSSGGSGTHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKV

SEQ ID NO: 963 - protein, 827 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKSGGSGSGSSGGSGTHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKV

SEQ ID NO: 964 - protein, 827 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKSGGSGSGSSGGSGTHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKV

SEQ ID NO: 965 - protein, 856 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSGGSGSGSSGGSGTHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKV

SEQ ID NO: 966 - protein, 856 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSGGSGSGSSGGSGTHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKV

SEQ ID NO: 967 - protein, 1075 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSSGGSGSGSSGGSGTHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKV

SEQ ID NO: 968 - protein, 1075 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSSGGSGSGSSGGSGTHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETEPKKKRKV

SEQ ID NO: 969 - protein, 999 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 970 - protein, 999 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 971 - protein, 968 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 972 - protein, 968 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 973 - protein, 933 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 974 - protein, 933 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 975 - protein, 885 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 976 - protein, 885 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 977 - protein, 831 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 978 - protein, 831 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 979 - protein, 808 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 980 - protein, 808 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 981 - protein, 744 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 982 - protein, 744 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 983 - protein, 675 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 984 - protein, 675 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 985 - protein, 641 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 986 - protein, 641 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 987 - protein, 572 aa, Artificial Sequence
  synthetic polypeptide
MHTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 988 - protein, 572 aa, Artificial Sequence
  synthetic polypeptide
MHTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETESGGSGSGSSGGSGTGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 989 - DNA, 6373 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctgtccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 990 - DNA, 6466 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaattccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 991 - DNA, 6571 bp, Artificial Sequence
  synthetic vector
ccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagtccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgata

SEQ ID NO: 992 - DNA, 6715 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 993 - DNA, 6877 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcatttccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 994 - DNA, 6946 bp, Artificial Sequence
  synthetic vector
ctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggattccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcag

SEQ ID NO: 995 - DNA, 7138 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctcctccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 996 - DNA, 7345 bp, Artificial Sequence
  synthetic vector
cgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgtccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtag

SEQ ID NO: 997 - DNA, 7447 bp, Artificial Sequence
  synthetic vector
ggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccata

SEQ ID NO: 998 - DNA, 7654 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaactccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 999 - DNA, 8467 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1000 - DNA, 8374 bp, Artificial Sequence
  synthetic vector
ccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctactt

SEQ ID NO: 1001 - DNA, 8269 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1002 - DNA, 8125 bp, Artificial Sequence
  synthetic vector
gacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctac

SEQ ID NO: 1003 - DNA, 7963 bp, Artificial Sequence
  synthetic vector
atctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagcc

SEQ ID NO: 1004 - DNA, 7813 bp, Artificial Sequence
  synthetic vector
tatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctcttccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtagg

SEQ ID NO: 1005 - DNA, 7702 bp, Artificial Sequence
  synthetic vector
gaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaac

SEQ ID NO: 1006 - DNA, 7495 bp, Artificial Sequence
  synthetic vector
ttgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgca

SEQ ID NO: 1007 - DNA, 7393 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1008 - DNA, 7186 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1009 - DNA, 8455 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1010 - DNA, 8362 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1011 - DNA, 8257 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1012 - DNA, 8113 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1013 - DNA, 7951 bp, Artificial Sequence
  synthetic vector
gtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggg

SEQ ID NO: 1014 - DNA, 7882 bp, Artificial Sequence
  synthetic vector
tatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtagg

SEQ ID NO: 1015 - DNA, 7690 bp, Artificial Sequence
  synthetic vector
gaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaac

SEQ ID NO: 1016 - DNA, 7483 bp, Artificial Sequence
  synthetic vector
ttgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgca

SEQ ID NO: 1017 - DNA, 7381 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1018 - DNA, 7174 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1019 - DNA, 6190 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1020 - DNA, 6457 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgcttccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1021 - DNA, 7078 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1022 - DNA, 7603 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1023 - DNA, 7621 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1024 - DNA, 7675 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggctccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1025 - DNA, 7891 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1026 - DNA, 7978 bp, Artificial Sequence
  synthetic vector
gcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggtccggagggtctggctccggatcaagtggtg

SEQ ID NO: 1027 - DNA, 8233 bp, Artificial Sequence
  synthetic vector
gagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaacttccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgacc

SEQ ID NO: 1028 - DNA, 8635 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagctccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1029 - DNA, 8650 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1030 - DNA, 8383 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1031 - DNA, 7762 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1032 - DNA, 7237 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1033 - DNA, 7219 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1034 - DNA, 7165 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1035 - DNA, 6949 bp, Artificial Sequence
  synthetic vector
gatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatg

SEQ ID NO: 1036 - DNA, 6862 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1037 - DNA, 6607 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1038 - DNA, 6205 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1039 - DNA, 8638 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1040 - DNA, 8371 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1041 - DNA, 7750 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1042 - DNA, 7225 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1043 - DNA, 7207 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1044 - DNA, 7153 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1045 - DNA, 6937 bp, Artificial Sequence
  synthetic vector
tcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatg

SEQ ID NO: 1046 - DNA, 6850 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1047 - DNA, 6595 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1048 - DNA, 6193 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1049 - DNA, 6217 bp, Artificial Sequence
  synthetic vector
acaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaag

SEQ ID NO: 1050 - DNA, 7426 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagcctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1051 - DNA, 7438 bp, Artificial Sequence
  synthetic vector
ttaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagccgatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcaca

SEQ ID NO: 1052 - DNA, 7105 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1053 - DNA, 7630 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1054 - DNA, 7648 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1055 - DNA, 6742 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1056 - DNA, 7165 bp, Artificial Sequence
  synthetic vector
gccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctcctccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgc

SEQ ID NO: 1057 - DNA, 7474 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1058 - DNA, 7681 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaactccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1059 - DNA, 8683 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagcctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1060 - DNA, 7795 bp, Artificial Sequence
  synthetic vector
tttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagcctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaac

SEQ ID NO: 1061 - DNA, 7270 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagcctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1062 - DNA, 7252 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagcctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1063 - DNA, 8158 bp, Artificial Sequence
  synthetic vector
gccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagcctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctc

SEQ ID NO: 1064 - DNA, 7735 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagcctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1065 - DNA, 7219 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagcctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1066 - DNA, 6193 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1067 - DNA, 1134 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctgtccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1068 - DNA, 1227 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaattccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1069 - DNA, 1332 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagtccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1070 - DNA, 1476 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1071 - DNA, 1638 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcatttccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1072 - DNA, 1707 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggattccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1073 - DNA, 1899 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctcctccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1074 - DNA, 2106 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgtccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1075 - DNA, 2208 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1076 - DNA, 2415 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaactccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1077 - DNA, 3228 bp, Artificial Sequence
  synthetic polynucleotide
atggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1078 - DNA, 3135 bp, Artificial Sequence
  synthetic polynucleotide
atggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1079 - DNA, 3030 bp, Artificial Sequence
  synthetic polynucleotide
atggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1080 - DNA, 2886 bp, Artificial Sequence
  synthetic polynucleotide
atggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1081 - DNA, 2724 bp, Artificial Sequence
  synthetic polynucleotide
atggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1082 - DNA, 2574 bp, Artificial Sequence
  synthetic polynucleotide
atgggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctcttccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1083 - DNA, 2463 bp, Artificial Sequence
  synthetic polynucleotide
atggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1084 - DNA, 2256 bp, Artificial Sequence
  synthetic polynucleotide
atggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1085 - DNA, 2154 bp, Artificial Sequence
  synthetic polynucleotide
atggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1086 - DNA, 1947 bp, Artificial Sequence
  synthetic polynucleotide
atggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1087 - DNA, 3216 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1088 - DNA, 3123 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1089 - DNA, 3018 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1090 - DNA, 2874 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1091 - DNA, 2712 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1092 - DNA, 2643 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1093 - DNA, 2451 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1094 - DNA, 2244 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1095 - DNA, 2142 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1096 - DNA, 1935 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1097 - DNA, 951 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1098 - DNA, 1218 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgcttccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1099 - DNA, 1839 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1100 - DNA, 2364 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1101 - DNA, 2382 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1102 - DNA, 2436 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggctccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1103 - DNA, 2652 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1104 - DNA, 2739 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggtccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1105 - DNA, 2994 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaacttccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1106 - DNA, 3396 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagctccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctcccaagaaaaagcggaaggtgtga

SEQ ID NO: 1107 - DNA, 3411 bp, Artificial Sequence
  synthetic polynucleotide
atggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1108 - DNA, 3144 bp, Artificial Sequence
  synthetic polynucleotide
atggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1109 - DNA, 2523 bp, Artificial Sequence
  synthetic polynucleotide
atggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1110 - DNA, 1998 bp, Artificial Sequence
  synthetic polynucleotide
atggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1111 - DNA, 1980 bp, Artificial Sequence
  synthetic polynucleotide
atggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1112 - DNA, 1926 bp, Artificial Sequence
  synthetic polynucleotide
atggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1113 - DNA, 1710 bp, Artificial Sequence
  synthetic polynucleotide
atggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1114 - DNA, 1623 bp, Artificial Sequence
  synthetic polynucleotide
atggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1115 - DNA, 1368 bp, Artificial Sequence
  synthetic polynucleotide
atggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1116 - DNA, 966 bp, Artificial Sequence
  synthetic polynucleotide
atggatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1117 - DNA, 3399 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1118 - DNA, 3132 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1119 - DNA, 2511 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1120 - DNA, 1986 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1121 - DNA, 1968 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1122 - DNA, 1914 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1123 - DNA, 1698 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1124 - DNA, 1611 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1125 - DNA, 1356 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1126 - DNA, 954 bp, Artificial Sequence
  synthetic polynucleotide
atgtcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1127 - DNA, 978 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctctagatttagctagcttaatcctctga

SEQ ID NO: 1128 - DNA, 2190 bp, Artificial Sequence
  synthetic polynucleotide
atggccccaaagaagaagcggaaggtcggtatccacggagtcccagcagcctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1129 - DNA, 2202 bp, Artificial Sequence
  synthetic polynucleotide
atggccccaaagaagaagcggaaggtcggtatccacggagtcccagcagccgatatcgagaagctttgcaaaaaagctgaagaagaggcaaaggaggcgcaagagaaagctgatgagttgcggcaacggcaccccgacagccaggctgctgaggatgctgaggacttggcaaatctggcggtggccgctgtcttgacggcttgcttgttggcccaagaacatccaaacgctgacattgcaaagctttgcattaaggccgcgtccgaagcggctgaagcagcttctaaggcagccgagctggcgcaacggcatcctgactcccaagcggcgagggacgctataaaactcgcatcacaagcagccagagctgtaatcctcgctattatgctcgcagccgaaaacccaaacgctgatattgccaaactgtgtataaaggcggctagtgaagccgcagaagctgcaagcaaagcagcagaacttgcccaacgccaccccgactcccaggcggctagagatgctataaaacttgcttctcaggctgcggaggcggtagaacgagcgatctggctggcagcagagaaccccaacgctgacattgccaaaaagtgtatcaaggcggcttccgaagccgccgaggaggccagcaaagcggcggaagaggcacagagacatccggactcacagaaagcacgcgacgagattaaagaggctagtcaaaaagcagaggaggtaaaagaacgctgtaagtcctccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1130 - DNA, 1866 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctctagatttagctagcttaatcctctga

SEQ ID NO: 1131 - DNA, 2391 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctctagatttagctagcttaatcctctga

SEQ ID NO: 1132 - DNA, 2409 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctctagatttagctagcttaatcctctga

SEQ ID NO: 1133 - DNA, 1503 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctctagatttagctagcttaatcctctga

SEQ ID NO: 1134 - DNA, 1926 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctcctccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctctagatttagctagcttaatcctctga

SEQ ID NO: 1135 - DNA, 2235 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctctagatttagctagcttaatcctctga

SEQ ID NO: 1136 - DNA, 2442 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaactccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctctagatttagctagcttaatcctctga

SEQ ID NO: 1137 - DNA, 3447 bp, Artificial Sequence
  synthetic polynucleotide
atggccccaaagaagaagcggaaggtcggtatccacggagtcccagcagcctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1138 - DNA, 2559 bp, Artificial Sequence
  synthetic polynucleotide
atggccccaaagaagaagcggaaggtcggtatccacggagtcccagcagcctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1139 - DNA, 2034 bp, Artificial Sequence
  synthetic polynucleotide
atggccccaaagaagaagcggaaggtcggtatccacggagtcccagcagcctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1140 - DNA, 2016 bp, Artificial Sequence
  synthetic polynucleotide
atggccccaaagaagaagcggaaggtcggtatccacggagtcccagcagcctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1141 - DNA, 2922 bp, Artificial Sequence
  synthetic polynucleotide
atggccccaaagaagaagcggaaggtcggtatccacggagtcccagcagcctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1142 - DNA, 2499 bp, Artificial Sequence
  synthetic polynucleotide
atggccccaaagaagaagcggaaggtcggtatccacggagtcccagcagcctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1143 - DNA, 1983 bp, Artificial Sequence
  synthetic polynucleotide
atggccccaaagaagaagcggaaggtcggtatccacggagtcccagcagcctcttccgacgaagaagaagcgcgcgagctgatcgagcgtgcgaaggaggctgcggaacgcgcgcaagaagctgctgagcgtaccggtgatccgcgcgtgcgtgaactcgctcgtgagctgaaacgcctggctcaggaagctgctgaagaagtgaagcgtgacccgtcttcctccgatgtgaacgaagcgctcaaactcatcgtggaagctatcgaggcggctgtggacgcgctcgaagcggctgaacgcaccggcgacccggaggttcgtgagctggcgcgtgagctcgtgcgcctcgcggttgaggctgcggaggaggtgcaacgtaacccatcctcctctgacgtgaatgaggctctccacagcatagtttacgctattgaagctgccatttttgcattggaagctgccgaaaggactggtgacccggaagtgagagaactcgcccgagagcttgtaagactggcggttgaggcggctgaagaagtccagcgaaatccgtccagccggaatgtcgagcacgcactgatgaggattgtgttggccatttacctggcagaagaaaatctccgcgaagctgaggagtctggcgatccggaaaaacgtgaaaaggctcgcgaacgtgttcgtgaggcggtggaacgtgcggaagaggttcagcgtgatccatccggttggctgaatcattccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1144 - DNA, 954 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctccgcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctcttga

SEQ ID NO: 1145 - protein, 377 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1146 - protein, 408 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1147 - protein, 443 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKESGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1148 - protein, 491 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1149 - protein, 545 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSISGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1150 - protein, 568 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1151 - protein, 632 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1152 - protein, 701 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1153 - protein, 735 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1154 - protein, 804 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1155 - protein, 1075 aa, Artificial Sequence
  synthetic polypeptide
MDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1156 - protein, 1044 aa, Artificial Sequence
  synthetic polypeptide
MDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1157 - protein, 1009 aa, Artificial Sequence
  synthetic polypeptide
MDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1158 - protein, 961 aa, Artificial Sequence
  synthetic polypeptide
MDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1159 - protein, 907 aa, Artificial Sequence
  synthetic polypeptide
MDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1160 - protein, 857 aa, Artificial Sequence
  synthetic polypeptide
MGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSSGGSGSGSSGGSGTMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1161 - protein, 820 aa, Artificial Sequence
  synthetic polypeptide
MDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1162 - protein, 751 aa, Artificial Sequence
  synthetic polypeptide
MDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1163 - protein, 717 aa, Artificial Sequence
  synthetic polypeptide
MDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1164 - protein, 648 aa, Artificial Sequence
  synthetic polypeptide
MDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1165 - protein, 1071 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1166 - protein, 1040 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1167 - protein, 1005 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1168 - protein, 957 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1169 - protein, 903 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1170 - protein, 880 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1171 - protein, 816 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1172 - protein, 747 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1173 - protein, 713 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1174 - protein, 644 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1175 - protein, 316 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1176 - protein, 405 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAASGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1177 - protein, 612 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1178 - protein, 787 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1179 - protein, 793 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1180 - protein, 811 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1181 - protein, 883 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1182 - protein, 912 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1183 - protein, 997 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1184 - protein, 1131 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSPKKKRKV

SEQ ID NO: 1185 - protein, 1136 aa, Artificial Sequence
  synthetic polypeptide
MDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1186 - protein, 1047 aa, Artificial Sequence
  synthetic polypeptide
MDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1187 - protein, 840 aa, Artificial Sequence
  synthetic polypeptide
MDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1188 - protein, 665 aa, Artificial Sequence
  synthetic polypeptide
MDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1189 - protein, 659 aa, Artificial Sequence
  synthetic polypeptide
MDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1190 - protein, 641 aa, Artificial Sequence
  synthetic polypeptide
MDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1191 - protein, 569 aa, Artificial Sequence
  synthetic polypeptide
MDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1192 - protein, 540 aa, Artificial Sequence
  synthetic polypeptide
MDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1193 - protein, 455 aa, Artificial Sequence
  synthetic polypeptide
MDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1194 - protein, 321 aa, Artificial Sequence
  synthetic polypeptide
MDIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTGKVSEYFDAVNDEKKYNDRLLKLLCVPFGYCIPRFKNLSIEALFDRNEAAKFDKEKKKVSGNSGSGPKKKRKV

SEQ ID NO: 1195 - protein, 1132 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1196 - protein, 1043 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1197 - protein, 836 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1198 - protein, 661 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1199 - protein, 655 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1200 - protein, 637 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1201 - protein, 565 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1202 - protein, 536 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1203 - protein, 451 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1204 - protein, 317 aa, Artificial Sequence
  synthetic polypeptide
MSSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTGKVSEYFDAVNDEKKYNDRLLKLLCVPFGYCIPRFKNLSIEALFDRNEAAKFDKEKKKVSGNSGSGPKKKRKV

SEQ ID NO: 1205 - protein, 325 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSLDLASLIL

SEQ ID NO: 1206 - protein, 729 aa, Artificial Sequence
  synthetic polypeptide
MAPKKKRKVGIHGVPAASSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1207 - protein, 733 aa, Artificial Sequence
  synthetic polypeptide
MAPKKKRKVGIHGVPAADIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKSSGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1208 - protein, 621 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSLDLASLIL

SEQ ID NO: 1209 - protein, 796 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSLDLASLIL

SEQ ID NO: 1210 - protein, 802 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSLDLASLIL

SEQ ID NO: 1211 - protein, 500 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSLDLASLIL

SEQ ID NO: 1212 - protein, 641 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSLDLASLIL

SEQ ID NO: 1213 - protein, 744 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSLDLASLIL

SEQ ID NO: 1214 - protein, 813 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSSLDLASLIL

SEQ ID NO: 1215 - protein, 1148 aa, Artificial Sequence
  synthetic polypeptide
MAPKKKRKVGIHGVPAASSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1216 - protein, 852 aa, Artificial Sequence
  synthetic polypeptide
MAPKKKRKVGIHGVPAASSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1217 - protein, 677 aa, Artificial Sequence
  synthetic polypeptide
MAPKKKRKVGIHGVPAASSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1218 - protein, 671 aa, Artificial Sequence
  synthetic polypeptide
MAPKKKRKVGIHGVPAASSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1219 - protein, 973 aa, Artificial Sequence
  synthetic polypeptide
MAPKKKRKVGIHGVPAASSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1220 - protein, 832 aa, Artificial Sequence
  synthetic polypeptide
MAPKKKRKVGIHGVPAASSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1221 - protein, 660 aa, Artificial Sequence
  synthetic polypeptide
MAPKKKRKVGIHGVPAASSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNHSGGSGSGSSGGSGTGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1222 - protein, 317 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTSGGSGSGSSGGSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSS

SEQ ID NO: 1223 - DNA, 6340 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctgtccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1224 - DNA, 6433 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaattccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1225 - DNA, 6538 bp, Artificial Sequence
  synthetic vector
ccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagtccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgata

SEQ ID NO: 1226 - DNA, 6682 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1227 - DNA, 6844 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcatttccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1228 - DNA, 6913 bp, Artificial Sequence
  synthetic vector
ctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggattccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcag

SEQ ID NO: 1229 - DNA, 7105 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctcctccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1230 - DNA, 7312 bp, Artificial Sequence
  synthetic vector
cgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgtccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtag

SEQ ID NO: 1231 - DNA, 7414 bp, Artificial Sequence
  synthetic vector
ggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccata

SEQ ID NO: 1232 - DNA, 7621 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaactccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1233 - DNA, 7867 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggagaacttgatgaattggtatacttactagatgggccaggttatgaccctatacattgcgatgtagtgacaaggggcggcagccaccttttcaatttttccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1234 - DNA, 7774 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggagaacttgatgaattggtatacttactagatgggccaggttatgaccctatacattgcgatgtagtgacaaggggcggcagccaccttttcaatttttccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1235 - DNA, 7669 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggagaacttgatgaattggtatacttactagatgggccaggttatgaccctatacattgcgatgtagtgacaaggggcggcagccaccttttcaatttttccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1236 - DNA, 7525 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggagaacttgatgaattggtatacttactagatgggccaggttatgaccctatacattgcgatgtagtgacaaggggcggcagccaccttttcaatttttccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1237 - DNA, 7363 bp, Artificial Sequence
  synthetic vector
gtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggagaacttgatgaattggtatacttactagatgggccaggttatgaccctatacattgcgatgtagtgacaaggggcggcagccaccttttcaatttttccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggg

SEQ ID NO: 1238 - DNA, 7294 bp, Artificial Sequence
  synthetic vector
tatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggagaacttgatgaattggtatacttactagatgggccaggttatgaccctatacattgcgatgtagtgacaaggggcggcagccaccttttcaatttttccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtagg

SEQ ID NO: 1239 - DNA, 7102 bp, Artificial Sequence
  synthetic vector
gaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggagaacttgatgaattggtatacttactagatgggccaggttatgaccctatacattgcgatgtagtgacaaggggcggcagccaccttttcaatttttccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaac

SEQ ID NO: 1240 - DNA, 6895 bp, Artificial Sequence
  synthetic vector
ttgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggagaacttgatgaattggtatacttactagatgggccaggttatgaccctatacattgcgatgtagtgacaaggggcggcagccaccttttcaatttttccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgca

SEQ ID NO: 1241 - DNA, 6793 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggagaacttgatgaattggtatacttactagatgggccaggttatgaccctatacattgcgatgtagtgacaaggggcggcagccaccttttcaatttttccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1242 - DNA, 6586 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggagaacttgatgaattggtatacttactagatgggccaggttatgaccctatacattgcgatgtagtgacaaggggcggcagccaccttttcaatttttccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1243 - DNA, 6157 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1244 - DNA, 6424 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgcttccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1245 - DNA, 7045 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1246 - DNA, 7570 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1247 - DNA, 7588 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1248 - DNA, 7642 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggctccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1249 - DNA, 7858 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1250 - DNA, 7945 bp, Artificial Sequence
  synthetic vector
gcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggtccggagggtctggctccggatcaagtggtg

SEQ ID NO: 1251 - DNA, 8200 bp, Artificial Sequence
  synthetic vector
gagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaacttccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgacc

SEQ ID NO: 1252 - DNA, 8602 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagctccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1253 - DNA, 8050 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggagaacttgatgaattggtatacttactagatgggccaggttatgaccctatacattgcgatgtagtgacaaggggcggcagccaccttttcaatttttccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1254 - DNA, 7783 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggagaacttgatgaattggtatacttactagatgggccaggttatgaccctatacattgcgatgtagtgacaaggggcggcagccaccttttcaatttttccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1255 - DNA, 7162 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggagaacttgatgaattggtatacttactagatgggccaggttatgaccctatacattgcgatgtagtgacaaggggcggcagccaccttttcaatttttccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1256 - DNA, 6637 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggagaacttgatgaattggtatacttactagatgggccaggttatgaccctatacattgcgatgtagtgacaaggggcggcagccaccttttcaatttttccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1257 - DNA, 6619 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggagaacttgatgaattggtatacttactagatgggccaggttatgaccctatacattgcgatgtagtgacaaggggcggcagccaccttttcaatttttccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1258 - DNA, 6565 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggagaacttgatgaattggtatacttactagatgggccaggttatgaccctatacattgcgatgtagtgacaaggggcggcagccaccttttcaatttttccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1259 - DNA, 6349 bp, Artificial Sequence
  synthetic vector
atgggagaacttgatgaattggtatacttactagatgggccaggttatgaccctatacattgcgatgtagtgacaaggggcggcagccaccttttcaatttttccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccacc

SEQ ID NO: 1260 - DNA, 6262 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggagaacttgatgaattggtatacttactagatgggccaggttatgaccctatacattgcgatgtagtgacaaggggcggcagccaccttttcaatttttccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1261 - DNA, 6007 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggagaacttgatgaattggtatacttactagatgggccaggttatgaccctatacattgcgatgtagtgacaaggggcggcagccaccttttcaatttttccggagggtctggctccggatcaagtggtggcagcggtaccgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1262 - DNA, 5604 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccacatgggagaacttgatgaattggtatacttactagatgggccaggttatgaccctatacattgcgatgtagtgacaaggggcggcagccaccttttcaatttttccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1263 - DNA, 1101 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctgtccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1264 - DNA, 1194 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaattccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1265 - DNA, 1299 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagtccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1266 - DNA, 1443 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1267 - DNA, 1605 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcatttccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1268 - DNA, 1674 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggattccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1269 - DNA, 1866 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctcctccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1270 - DNA, 2073 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgtccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1271 - DNA, 2175 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1272 - DNA, 2382 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaactccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1273 - DNA, 2628 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1274 - DNA, 2535 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1275 - DNA, 2430 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1276 - DNA, 2286 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1277 - DNA, 2124 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1278 - DNA, 2055 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1279 - DNA, 1863 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1280 - DNA, 1656 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1281 - DNA, 1554 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1282 - DNA, 1347 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1283 - DNA, 918 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1284 - DNA, 1185 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgcttccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1285 - DNA, 1806 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1286 - DNA, 2331 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1287 - DNA, 2349 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1288 - DNA, 2403 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggctccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1289 - DNA, 2619 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1290 - DNA, 2706 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggtccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1291 - DNA, 2961 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaacttccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1292 - DNA, 3363 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagctccggagggtctggctccggatcaagtggtggcagcggtaccggttctgttgttattgttggtagaattattttatctggtagtggtagtatcacggcctactcccaacagacgcggggcctacttggttgcatcatcactagcctcacaggccgggacaagaaccaggtcgaaggggaggttcaagtggtttctaccgcaacacaatctttcctggcgacctgcgtcaacggcgtgtgctggactgtctaccatggcgctggctcgaagaccctagccggtccaaaaggtccaatcacccaaatgtacaccaatgtagaccaggacctcgtcggctggcaggcgcctccaggggcgcgctccttgacaccatgcacctgtggcagctcggacctttacttggtcacgagacatgctgatgtcattccggtgcgccggcgaggcgacagcaggggaagtctactctcccccaggcccgtctcctacctgaaaggctccgcaggtggtccattgctttgcccttcggggcacgctgtgggcatcttccgggctgctgtgtgcacccggggggtcgcgaaggcggtggacttcgtgcccgttgagtctatggaaactaccatgcggtctcccaagaaaaagcggaaggtgtga

SEQ ID NO: 1293 - DNA, 2811 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1294 - DNA, 2544 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1295 - DNA, 1923 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1296 - DNA, 1398 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1297 - DNA, 1380 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1298 - DNA, 1326 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1299 - DNA, 1110 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1300 - DNA, 1023 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1301 - DNA, 768 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtaccgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1302 - DNA, 366 bp, Artificial Sequence
  synthetic polynucleotide
atgggagaacttgatgaattggtatacttactagatgggccaggttatgaccctatacattgcgatgtagtgacaaggggcggcagccaccttttcaatttttccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1303 - protein, 366 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLSGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1304 - protein, 397 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNSGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1305 - protein, 432 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKESGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1306 - protein, 480 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLSGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1307 - protein, 534 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSISGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1308 - protein, 557 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDSGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1309 - protein, 621 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSSGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1310 - protein, 690 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMSGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1311 - protein, 724 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNSGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1312 - protein, 793 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENSGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1313 - protein, 875 aa, Artificial Sequence
  synthetic polypeptide
MGELDELVYLLDGPGYDPIHCDVVTRGGSHLFNFSGGSGSGSSGGSGTDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1314 - protein, 844 aa, Artificial Sequence
  synthetic polypeptide
MGELDELVYLLDGPGYDPIHCDVVTRGGSHLFNFSGGSGSGSSGGSGTNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1315 - protein, 809 aa, Artificial Sequence
  synthetic polypeptide
MGELDELVYLLDGPGYDPIHCDVVTRGGSHLFNFSGGSGSGSSGGSGTGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1316 - protein, 761 aa, Artificial Sequence
  synthetic polypeptide
MGELDELVYLLDGPGYDPIHCDVVTRGGSHLFNFSGGSGSGSSGGSGTDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1317 - protein, 707 aa, Artificial Sequence
  synthetic polypeptide
MGELDELVYLLDGPGYDPIHCDVVTRGGSHLFNFSGGSGSGSSGGSGTMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1318 - protein, 684 aa, Artificial Sequence
  synthetic polypeptide
MGELDELVYLLDGPGYDPIHCDVVTRGGSHLFNFSGGSGSGSSGGSGTMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1319 - protein, 620 aa, Artificial Sequence
  synthetic polypeptide
MGELDELVYLLDGPGYDPIHCDVVTRGGSHLFNFSGGSGSGSSGGSGTFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1320 - protein, 551 aa, Artificial Sequence
  synthetic polypeptide
MGELDELVYLLDGPGYDPIHCDVVTRGGSHLFNFSGGSGSGSSGGSGTFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1321 - protein, 517 aa, Artificial Sequence
  synthetic polypeptide
MGELDELVYLLDGPGYDPIHCDVVTRGGSHLFNFSGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1322 - protein, 448 aa, Artificial Sequence
  synthetic polypeptide
MGELDELVYLLDGPGYDPIHCDVVTRGGSHLFNFSGGSGSGSSGGSGTGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1323 - protein, 305 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTSGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1324 - protein, 394 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAASGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1325 - protein, 601 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLSGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1326 - protein, 776 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1327 - protein, 782 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKSGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1328 - protein, 800 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGSGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1329 - protein, 872 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKSGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1330 - protein, 901 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1331 - protein, 986 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETSGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1332 - protein, 1120 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSSGGSGSGSSGGSGTGSVVIVGRIILSGSGSITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRSPKKKRKV

SEQ ID NO: 1333 - protein, 936 aa, Artificial Sequence
  synthetic polypeptide
MGELDELVYLLDGPGYDPIHCDVVTRGGSHLFNFSGGSGSGSSGGSGTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1334 - protein, 847 aa, Artificial Sequence
  synthetic polypeptide
MGELDELVYLLDGPGYDPIHCDVVTRGGSHLFNFSGGSGSGSSGGSGTFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1335 - protein, 640 aa, Artificial Sequence
  synthetic polypeptide
MGELDELVYLLDGPGYDPIHCDVVTRGGSHLFNFSGGSGSGSSGGSGTPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1336 - protein, 465 aa, Artificial Sequence
  synthetic polypeptide
MGELDELVYLLDGPGYDPIHCDVVTRGGSHLFNFSGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1337 - protein, 459 aa, Artificial Sequence
  synthetic polypeptide
MGELDELVYLLDGPGYDPIHCDVVTRGGSHLFNFSGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1338 - protein, 441 aa, Artificial Sequence
  synthetic polypeptide
MGELDELVYLLDGPGYDPIHCDVVTRGGSHLFNFSGGSGSGSSGGSGTKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1339 - protein, 369 aa, Artificial Sequence
  synthetic polypeptide
MGELDELVYLLDGPGYDPIHCDVVTRGGSHLFNFSGGSGSGSSGGSGTDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1340 - protein, 340 aa, Artificial Sequence
  synthetic polypeptide
MGELDELVYLLDGPGYDPIHCDVVTRGGSHLFNFSGGSGSGSSGGSGTSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1341 - protein, 255 aa, Artificial Sequence
  synthetic polypeptide
MGELDELVYLLDGPGYDPIHCDVVTRGGSHLFNFSGGSGSGSSGGSGTAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1342 - protein, 121 aa, Artificial Sequence
  synthetic polypeptide
MGELDELVYLLDGPGYDPIHCDVVTRGGSHLFNFSGGSGSGSSGGSGTGKVSEYFDAVNDEKKYNDRLLKLLCVPFGYCIPRFKNLSIEALFDRNEAAKFDKEKKKVSGNSGSGPKKKRKV

SEQ ID NO: 1343 - DNA, 6490 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1344 - DNA, 6511 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1345 - DNA, 8887 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1346 - DNA, 6757 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgcttccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1347 - DNA, 6778 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgcttccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1348 - DNA, 8620 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1349 - DNA, 7378 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1350 - DNA, 7399 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1351 - DNA, 7969 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1352 - DNA, 7999 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1353 - DNA, 7903 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1354 - DNA, 7924 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1355 - DNA, 7444 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1356 - DNA, 7474 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1357 - DNA, 7921 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1358 - DNA, 7942 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1359 - DNA, 7426 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1360 - DNA, 7456 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1361 - DNA, 7975 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1362 - DNA, 7996 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1363 - DNA, 7372 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1364 - DNA, 7402 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1365 - DNA, 8191 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1366 - DNA, 8212 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1367 - DNA, 7156 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1368 - DNA, 7186 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1369 - DNA, 8278 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1370 - DNA, 8299 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1371 - DNA, 7099 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1372 - DNA, 8935 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1373 - DNA, 8956 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1374 - DNA, 6442 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1375 - DNA, 6673 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1376 - DNA, 6694 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1377 - DNA, 8704 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1378 - DNA, 6766 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaattccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1379 - DNA, 6787 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaattccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1380 - DNA, 8611 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1381 - DNA, 6871 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1382 - DNA, 6892 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1383 - DNA, 8506 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1384 - DNA, 7015 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1385 - DNA, 7036 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1386 - DNA, 8362 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1387 - DNA, 7177 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcatttccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1388 - DNA, 7198 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcatttccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1389 - DNA, 8200 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1390 - DNA, 7246 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggattccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1391 - DNA, 7267 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggattccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1392 - DNA, 8131 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1393 - DNA, 7438 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctcctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1394 - DNA, 7459 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctcctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1395 - DNA, 7939 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1396 - DNA, 7645 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1397 - DNA, 7666 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1398 - DNA, 7732 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1399 - DNA, 7747 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1400 - DNA, 7768 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1401 - DNA, 7600 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1402 - DNA, 7630 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1403 - DNA, 7954 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaactccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1404 - DNA, 7975 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaactccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1405 - DNA, 7423 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1406 - DNA, 8983 bp, Artificial Sequence
  synthetic vector
cgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtg

SEQ ID NO: 1407 - DNA, 8440 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1408 - DNA, 8614 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1409 - DNA, 9004 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcccaagaaaaagcggaaggtggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1410 - DNA, 8461 bp, Artificial Sequence
  synthetic vector
tgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcccaagaaaaagcggaaggtggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgaca

SEQ ID NO: 1411 - DNA, 8635 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcccaagaaaaagcggaaggtggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1412 - DNA, 8410 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1413 - DNA, 8446 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggactgcctccacttgaaagactgacactgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1414 - DNA, 8584 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1415 - DNA, 1251 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1416 - DNA, 1272 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtga

SEQ ID NO: 1417 - DNA, 3648 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1418 - DNA, 1518 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgcttccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1419 - DNA, 1539 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgcttccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtga

SEQ ID NO: 1420 - DNA, 3381 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1421 - DNA, 2139 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1422 - DNA, 2160 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtga

SEQ ID NO: 1423 - DNA, 2730 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctga

SEQ ID NO: 1424 - DNA, 2760 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1425 - DNA, 2664 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1426 - DNA, 2685 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtga

SEQ ID NO: 1427 - DNA, 2205 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctga

SEQ ID NO: 1428 - DNA, 2235 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1429 - DNA, 2682 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1430 - DNA, 2703 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtga

SEQ ID NO: 1431 - DNA, 2187 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctga

SEQ ID NO: 1432 - DNA, 2217 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1433 - DNA, 2736 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1434 - DNA, 2757 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtga

SEQ ID NO: 1435 - DNA, 2133 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctga

SEQ ID NO: 1436 - DNA, 2163 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1437 - DNA, 2952 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1438 - DNA, 2973 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtga

SEQ ID NO: 1439 - DNA, 1917 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctga

SEQ ID NO: 1440 - DNA, 1947 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1441 - DNA, 3039 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1442 - DNA, 3060 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtga

SEQ ID NO: 1443 - DNA, 1860 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1444 - DNA, 3696 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1445 - DNA, 3717 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtga

SEQ ID NO: 1446 - DNA, 1203 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1447 - DNA, 1434 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1448 - DNA, 1455 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtga

SEQ ID NO: 1449 - DNA, 3465 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1450 - DNA, 1527 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaattccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1451 - DNA, 1548 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaattccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtga

SEQ ID NO: 1452 - DNA, 3372 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1453 - DNA, 1632 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1454 - DNA, 1653 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtga

SEQ ID NO: 1455 - DNA, 3267 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1456 - DNA, 1776 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1457 - DNA, 1797 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtga

SEQ ID NO: 1458 - DNA, 3123 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1459 - DNA, 1938 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcatttccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1460 - DNA, 1959 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcatttccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtga

SEQ ID NO: 1461 - DNA, 2961 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1462 - DNA, 2007 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggattccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1463 - DNA, 2028 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggattccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtga

SEQ ID NO: 1464 - DNA, 2892 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1465 - DNA, 2199 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctcctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1466 - DNA, 2220 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctcctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtga

SEQ ID NO: 1467 - DNA, 2700 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1468 - DNA, 2406 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1469 - DNA, 2427 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtga

SEQ ID NO: 1470 - DNA, 2493 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1471 - DNA, 2508 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1472 - DNA, 2529 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtga

SEQ ID NO: 1473 - DNA, 2361 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctga

SEQ ID NO: 1474 - DNA, 2391 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1475 - DNA, 2715 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaactccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1476 - DNA, 2736 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaactccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccaagaaaaagcggaaggtgtga

SEQ ID NO: 1477 - DNA, 2184 bp, Artificial Sequence
  synthetic polynucleotide
gctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 1478 - DNA, 3744 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1479 - DNA, 3201 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1480 - DNA, 3375 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1481 - DNA, 3765 bp, Artificial Sequence
  synthetic polynucleotide
atgcccaagaaaaagcggaaggtggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1482 - DNA, 3222 bp, Artificial Sequence
  synthetic polynucleotide
atgcccaagaaaaagcggaaggtggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1483 - DNA, 3396 bp, Artificial Sequence
  synthetic polynucleotide
atgcccaagaaaaagcggaaggtggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1484 - DNA, 3171 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1485 - DNA, 3207 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggactgcctccacttgaaagactgacactgtccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1486 - DNA, 3345 bp, Artificial Sequence
  synthetic polynucleotide
atggctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctccggagggtctggctccggatcaagtggtggcagcggtaccgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttga

SEQ ID NO: 1487 - protein, 416 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1488 - protein, 423 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPKKKRKV

SEQ ID NO: 1489 - protein, 1215 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1490 - protein, 505 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAASGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1491 - protein, 512 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAASGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPKKKRKV

SEQ ID NO: 1492 - protein, 1126 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1493 - protein, 712 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1494 - protein, 719 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPKKKRKV

SEQ ID NO: 1495 - protein, 909 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 1496 - protein, 919 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1497 - protein, 887 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1498 - protein, 894 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPKKKRKV

SEQ ID NO: 1499 - protein, 734 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 1500 - protein, 744 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1501 - protein, 893 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1502 - protein, 900 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPKKKRKV

SEQ ID NO: 1503 - protein, 728 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 1504 - protein, 738 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1505 - protein, 911 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1506 - protein, 918 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPKKKRKV

SEQ ID NO: 1507 - protein, 710 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 1508 - protein, 720 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1509 - protein, 983 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1510 - protein, 990 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPKKKRKV

SEQ ID NO: 1511 - protein, 638 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 1512 - protein, 648 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1513 - protein, 1012 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1514 - protein, 1019 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPKKKRKV

SEQ ID NO: 1515 - protein, 619 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1516 - protein, 1231 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1517 - protein, 1238 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPKKKRKV

SEQ ID NO: 1518 - protein, 400 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTGKVSEYFDAVNDEKKYNDRLLKLLCVPFGYCIPRFKNLSIEALFDRNEAAKFDKEKKKVSGNSGSGPKKKRKV

SEQ ID NO: 1519 - protein, 477 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1520 - protein, 484 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPKKKRKV

SEQ ID NO: 1521 - protein, 1154 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1522 - protein, 508 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1523 - protein, 515 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPKKKRKV

SEQ ID NO: 1524 - protein, 1123 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1525 - protein, 543 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKESGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1526 - protein, 550 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKESGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPKKKRKV

SEQ ID NO: 1527 - protein, 1088 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1528 - protein, 591 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1529 - protein, 598 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPKKKRKV

SEQ ID NO: 1530 - protein, 1040 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1531 - protein, 645 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSISGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1532 - protein, 652 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSISGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPKKKRKV

SEQ ID NO: 1533 - protein, 986 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1534 - protein, 668 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1535 - protein, 675 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPKKKRKV

SEQ ID NO: 1536 - protein, 963 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1537 - protein, 732 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1538 - protein, 739 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPKKKRKV

SEQ ID NO: 1539 - protein, 899 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1540 - protein, 801 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1541 - protein, 808 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPKKKRKV

SEQ ID NO: 1542 - protein, 830 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1543 - protein, 835 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1544 - protein, 842 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPKKKRKV

SEQ ID NO: 1545 - protein, 786 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 1546 - protein, 796 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1547 - protein, 904 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1548 - protein, 911 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPKKKRKV

SEQ ID NO: 1549 - protein, 727 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 1550 - protein, 1247 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1551 - protein, 1066 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1552 - protein, 1124 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1553 - protein, 1254 aa, Artificial Sequence
  synthetic polypeptide
MPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1554 - protein, 1073 aa, Artificial Sequence
  synthetic polypeptide
MPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1555 - protein, 1131 aa, Artificial Sequence
  synthetic polypeptide
MPKKKRKVAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1556 - protein, 1056 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1557 - protein, 1068 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGLPPLERLTLSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1558 - protein, 1114 aa, Artificial Sequence
  synthetic polypeptide
MAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATASGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSSGGSGSGSSGGSGTAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 1559 - DNA, 5530 bp, Artificial Sequence
  synthetic vector
aacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggcc

SEQ ID NO: 1560 - DNA, 7909 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1561 - DNA, 5797 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1562 - DNA, 7642 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1563 - DNA, 6418 bp, Artificial Sequence
  synthetic vector
cactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcg

SEQ ID NO: 1564 - DNA, 7021 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1565 - DNA, 6634 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgccccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1566 - DNA, 6805 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1567 - DNA, 6943 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1568 - DNA, 6496 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1569 - DNA, 6961 bp, Artificial Sequence
  synthetic vector
cttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgct

SEQ ID NO: 1570 - DNA, 6478 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1571 - DNA, 7015 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1572 - DNA, 6424 bp, Artificial Sequence
  synthetic vector
tgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagt

SEQ ID NO: 1573 - DNA, 7231 bp, Artificial Sequence
  synthetic vector
ggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggc

SEQ ID NO: 1574 - DNA, 6208 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1575 - DNA, 7318 bp, Artificial Sequence
  synthetic vector
accgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgat

SEQ ID NO: 1576 - DNA, 6121 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1577 - DNA, 7507 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1578 - DNA, 5932 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1579 - DNA, 7573 bp, Artificial Sequence
  synthetic vector
ttcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcgga

SEQ ID NO: 1580 - DNA, 5866 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1581 - DNA, 7651 bp, Artificial Sequence
  synthetic vector
ttcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgcccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcaga

SEQ ID NO: 1582 - DNA, 5788 bp, Artificial Sequence
  synthetic vector
gccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagg

SEQ ID NO: 1583 - DNA, 7687 bp, Artificial Sequence
  synthetic vector
tatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaaca

SEQ ID NO: 1584 - DNA, 5752 bp, Artificial Sequence
  synthetic vector
gaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtca

SEQ ID NO: 1585 - DNA, 7975 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1586 - DNA, 5464 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1587 - DNA, 5713 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1588 - DNA, 7726 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1589 - DNA, 5806 bp, Artificial Sequence
  synthetic vector
aacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaatcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggcc

SEQ ID NO: 1590 - DNA, 7633 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 1591 - DNA, 5911 bp, Artificial Sequence
  synthetic vector
ggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggc

SEQ ID NO: 1592 - DNA, 7528 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 1593 - DNA, 6055 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag
